United States Patent 12,569,549 (FLAVIVIRUS VACCINE) - sequence listing, part 26

SEQ ID NO: 10911 - RNA, 9879 nt, synthetic construct
  misc_feature 1..9879: note = derived and/or modified CDS sequence (opt2) from DENV-1__GU131839__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagaccgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgtccagggcaagaagatgatccgcccccagcccatggagcacaagtactcctggaagtcctggggcaaggccaagatcatcggcgccgacacccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccgccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacaacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcacctccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttccgcgagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacgtctacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgactccgagggcgccctctggtga

SEQ ID NO: 10912 - RNA, 9879 nt, synthetic construct
  misc_feature 1..9879: note = derived and/or modified CDS sequence (opt2) from DENV-1__GU131841__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccttcttcctcgcctacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttctccacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagcgcggctcctccatcggcaagatgttcgaggccaccgcccgcggcgcccgccgcatggccatcctcggcgacaccgcctgggacttcggctccatcggcggcgtcttcacctccgtcggcaagctcgtccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacggccagcgcgcctggaacatctgggaggtcgaggactacggcttcggcgtcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcacctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgagttccagccccaccagctctggaccaccctcctctccctcaccttcgtcaagaccaccctctccctcgactacgcctggaagaccaccgccatggtcctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccctcaacgagggcatcatggccatcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagcaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcaccgcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggctacgtcgccgccgagaaccaccagcacgccaccatgctcgacgtcgacctccaccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatgccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccacccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggtccagctcatccgccagatggagtccgagggcatcttcctcccctccgagctcgagacccccaacctcgccgagcgcgccctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10913 - RNA, 9879 nt, synthetic construct
  misc_feature 1..9879: note = derived and/or modified CDS sequence (opt2) from DENV-1__GQ868601__SS-prME
  source 1..9879: mol_type = other RNA
tccgtcaccatgctcctcatgctcctccccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaagaacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcacccgcctcgagggcaagatcgtccagtacgagaacctcaagtactccgtcatcgtcaccgtccacaccggcgaccagcaccaggtcggcaacgagaccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccaggtcaagtacgagggcaccgacgccccctgcaagatccccttcctcacccaggacgagaagggcgtcacccagaacggccgcctcatcaccgccaaccccatcgtcaccgacaaggagaagcccgtcaacatcgagaccgagccccccttcggcgagtcctacatcgtcgtcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcctcttcacctccgtcggcaagctcatccaccaggtcttcggcaccgcctacggcgtcctcttctccggcgtctcctggaccatgaagatcggcatcggcatcctcctcacctggctcggcctcaactcccgctccacctccctctccatgacctgcatcgccgtcggcatggtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaactacatcctcctcgagaacgacatgaagttcaccgtcgtcgtcggcgacgccaacggcatcctcgcccagggcaagaagatgatccgcccccagcccatggagcacaagtactcctggaagtcctggggcaaggccaagatcatcggcgccgacatccagaacaccaccttcatcatcgacggccccgacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggctaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtccgctccatggtctccgccggctccggcgaggtcgactccttctccctcggcatcctctgcgtctccatcctcatcgaggaggtcatgcgctcccgctggtcccgccgcatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagccccaccagctctggaccaccctcctctccctcaccttcatccgcaccaccctctccctcgactacgcctggaagaccatggccatggccctctccatcgtctccctcttccccctctgcctctccaccacctcccagaagaccacctggctccccgtcctcctcggctccttcggctgcaagcccctcaccatgttcctcatcaccgagaacaagatctggggccgcaagtcctggcccatcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccatgtccatccccgccaccctcttcgtctggtacttctggcagaagaagaagcagcgctccggcgtcctctgggacaccccctccccccccgaggtcgagcgcgccgtcctcgacgacggcatctaccgcatcctccagcgcggcctcctcggccgctcccaggtcggcgtcggcgtcttccaggacggcgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttcaagaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgaccccgcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgactggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccagaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcaccctccgcgcccagaacgccctcgacaacctcgtcatgctccacaactccgagcagggcggcaaggcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccaccatgctcgacgtcgacctccgccccgcctccgcctggaccctctacgccgtcgccaccaccgtcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcaccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagaacgagcacaagtccacctggcactacgacgaggacaacccctacaagacctgggcctaccacggctcctacgaggtcaagccctccggctccgcctcctccatggtcaacggcgtcgtccgcctcctcaccaagccctgggacgtcatccccatggtcacccagatcgccatgaccgacaccacccccttcggccagcagcgcgtcttcaaggagaaggtcgacacccgcaccccccgcgccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagtccggcaccgtcatggacgtcatctcccgccgcgaccagcgcggctccggccaggtcggcacctacggcctcaacaccttcaccaacatggaggtccagctcatccgccagatggagtccgagggcatcttctccccctccgagctcgagacccccaacctcgccaagcgcgtcctcgactggctcgagaagcagggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggaggtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10914 - RNA, 9879 nt, synthetic construct
  misc_feature 1..9879: note = derived and/or modified CDS sequence (opt2) from DENV-1__EU660390__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcatcgtcggcgacgtcgccggcatcctcggccagggccgcaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcgtcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10915 - RNA, 9879 nt, synthetic construct
  misc_feature 1..9879: note = derived and/or modified CDS sequence (opt2) from DENV-1__EU660391__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggacggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagtacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10916 - RNA, 9879 nt, synthetic construct
  misc_feature 1..9879: note = derived and/or modified CDS sequence (opt2) from DENV-1__EU660393__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcatcacccagtccggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctaccgccgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10917 - RNA, 9879 nt, synthetic construct
  misc_feature 1..9879: note = derived and/or modified CDS sequence (opt2) from DENV-1__EU660401__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 10918 - RNA, 9879 nt, synthetic construct
  misc_feature 1..9879: note = derived and/or modified CDS sequence (opt2) from DENV-1__FJ373305__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatcatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccgtctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 10919 - RNA, 9879 nt, synthetic construct
  misc_feature 1..9879: note = derived and/or modified CDS sequence (opt2) from DENV-1__EU660402__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcatcgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagatctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctacgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgccgcctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcccacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcatgctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 10920 - RNA, 9879 nt, synthetic construct
  misc_feature 1..9879: note = derived and/or modified CDS sequence (opt2) from DENV-1__EU660403__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatcatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 10921 - RNA, 9879 nt, synthetic construct
  misc_feature 1..9879: note = derived and/or modified CDS sequence (opt2) from DENV-1__EU660397__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctccgcggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10922 - RNA, 9879 nt, synthetic construct
  misc_feature 1..9879: note = derived and/or modified CDS sequence (opt2) from DENV-1__EU687247__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagatctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgccgcctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcaactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 10923 - RNA, 9879 nt, synthetic construct
  misc_feature 1..9879: note = derived and/or modified CDS sequence (opt2) from DENV-1__EU660412__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgaggccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgatctccatgaagcgcttcaagaacgagtccgaccccgagggcgccctctggtga

SEQ ID NO: 10924 - RNA, 9879 nt, synthetic construct
  misc_feature 1..9879: note = derived and/or modified CDS sequence (opt2) from DENV-1__EU660418__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggcacttctggcagaagaagaagcagcgctccggcgtcctctgggacaccccctccccccccgaggtcggccgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaacatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10925 - RNA, 9879 nt, synthetic construct
  misc_feature 1..9879: note = derived and/or modified CDS sequence (opt2) from DENV-1__EU677151__SS-prME
  source 1..9879: mol_type = other RNA
tccgtcaccatgctcctcatgctcatccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcgcctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgctcctgcatcatggtcggcgccaacgcctccgaccgcatgggcatgggcaccacctacctcgccctcatggccaccttcaagatgcgccccatggtcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgcccgcaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctctccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10926 - RNA, 9879 nt, synthetic construct
  misc_feature 1..9879: note = derived and/or modified CDS sequence (opt2) from DENV-1__EU677152__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10927 - RNA, 9879 nt, synthetic construct
  misc_feature 1..9879: note = derived and/or modified CDS sequence (opt2) from DENV-1__EU677155__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcacctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccggctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10928 - RNA, 9879 nt, synthetic construct
  misc_feature 1..9879: note = derived and/or modified CDS sequence (opt2) from DENV-1__EU677157__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccctcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccaagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10929 - RNA, 9879 nt, synthetic construct
  misc_feature 1..9879: note = derived and/or modified CDS sequence (opt2) from DENV-1__EU677158__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatcatcgaggaggtcatgcgctcccgctggtcccgcaagatgctcatgaccggcaccctcgccgtcttcgtcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 10930 - RNA, 9879 nt, synthetic construct
  misc_feature 1..9879: note = derived and/or modified CDS sequence (opt2) from DENV-1__EU677159__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccatctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgaggccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcggcaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgatctccatgaagcgcttcaagaacgagtccgaccccgagggcgccctctggtga

SEQ ID NO: 10931 - RNA, 9879 nt, synthetic construct
  misc_feature 1..9879: note = derived and/or modified CDS sequence (opt2) from DENV-1__EU677160__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcgtcctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccctcgtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgcccgccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10932 - RNA, 9879 nt, synthetic construct
  misc_feature 1..9879: note = derived and/or modified CDS sequence (opt2) from DENV-1__EU677162__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggccgcatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10933 - RNA, 9879 nt, synthetic construct
  misc_feature 1..9879: note = derived and/or modified CDS sequence (opt2) from DENV-1__EU677164__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatcgccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagaactacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcctcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccaccctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10934 - RNA, 9879 nt, synthetic construct
  misc_feature 1..9879: note = derived and/or modified CDS sequence (opt2) from DENV-1__EU677165__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatcacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgccaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctccgcggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctcgcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10935 - RNA, 9879 nt, synthetic construct
  misc_feature 1..9879: note = derived and/or modified CDS sequence (opt2) from DENV-1__EU677140__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcaagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 10936 - RNA, 9879 nt, synthetic construct
  misc_feature 1..9879: note = derived and/or modified CDS sequence (opt2) from DENV-1__EU677166__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgcccgctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcaactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10937 - RNA, 9879 nt, synthetic construct
  misc_feature 1..9879: note = derived and/or modified CDS sequence (opt2) from DENV-1__EU677170__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggatgaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgcccgctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccatcctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10938 - RNA, 9879 nt, synthetic construct
  misc_feature 1..9879: note = derived and/or modified CDS sequence (opt2) from DENV-1__EU677171__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgcccgctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10939 - RNA, 9879 nt, synthetic construct
  misc_feature 1..9879: note = derived and/or modified CDS sequence (opt2) from DENV-1__EU677172__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcaccatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10940 - RNA, 9879 nt, synthetic construct
  misc_feature 1..9879: note = derived and/or modified CDS sequence (opt2) from DENV-1__EU677173__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgccaccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacgccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagtacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 10941 - RNA, 9879 nt, synthetic construct
  misc_feature 1..9879: note = derived and/or modified CDS sequence (opt2) from DENV-1__EU726779__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccttctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcggccgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaacatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10942 - RNA, 9879 nt, synthetic construct
  misc_feature 1..9879: note = derived and/or modified CDS sequence (opt2) from DENV-1__EU677176__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggcctcttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgctcctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagaccaagcgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgcccgcaacggcaccgtcatggacgtcatctcccgccgcgaccagcgcggctccggccaggtcggcacctacggcctcaacaccttcaccaacatggaggcccagctcatccgccagatggagtccgagcgcatcttctccccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctctccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgactccgaccccgagggcgccctctggtga

SEQ ID NO: 10943 - RNA, 9879 nt, synthetic construct
  misc_feature 1..9879: note = derived and/or modified CDS sequence (opt2) from DENV-1__EU726780__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaagaccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggtcaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatctccgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcatcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10944 - RNA, 9879 nt, synthetic construct
  misc_feature 1..9879: note = derived and/or modified CDS sequence (opt2) from DENV-1__EU726781__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgtcgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagaactacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcctcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10945 - RNA, 9879 nt, synthetic construct
  misc_feature 1..9879: note = derived and/or modified CDS sequence (opt2) from DENV-1__EU726782__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatcatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagatccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 10946 - RNA, 9879 nt, synthetic construct
  misc_feature 1..9879: note = derived and/or modified CDS sequence (opt2) from DENV-1__EU677178__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacacctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 10947 - RNA, 9879 nt, synthetic construct
  misc_feature 1..9879: note = derived and/or modified CDS sequence (opt2) from DENV-1__EU687251__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcaagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10948 - RNA, 9879 nt, synthetic construct
  misc_feature 1..9879: note = derived and/or modified CDS sequence (opt2) from DENV-1__FJ024427__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccggctacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcgccgacgccccctgcaagatccccttctccacccaggacgagaagggcatcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttcaaccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgcccgctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10949 - RNA, 9879 nt, synthetic construct
  misc_feature 1..9879: note = derived and/or modified CDS sequence (opt2) from DENV-1__FJ024428__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcaccgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcgtcggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccgtcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10950 - RNA, 9879 nt, synthetic construct
  misc_feature 1..9879: note = derived and/or modified CDS sequence (opt2) from DENV-1__FJ024429__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcatgacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagatcgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcgtcggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccgtcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagcgcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10951 - RNA, 9879 nt, synthetic construct
  misc_feature 1..9879: note = derived and/or modified CDS sequence (opt2) from DENV-1__FJ024430__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgctcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgccctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcggccgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaacatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccaccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccgtcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10952 - RNA, 9879 nt, synthetic construct
  misc_feature 1..9879: note = derived and/or modified CDS sequence (opt2) from DENV-1__FJ024433__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccatctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctccgcggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggaacctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10953 - RNA, 9879 nt, synthetic construct
  misc_feature 1..9879: note = derived and/or modified CDS sequence (opt2) from DENV-1__FJ024434__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagtacaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccgccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgaggccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgatctccatgaagcgcttcaagaacgagtccgaccccgagggcgccctctggtga

SEQ ID NO: 10954 - RNA, 9879 nt, synthetic construct
  misc_feature 1..9879: note = derived and/or modified CDS sequence (opt2) from DENV-1__FJ024435__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcaccgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatctacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcgtcggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccgtcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10955 - RNA, 9879 nt, synthetic construct
  misc_feature 1..9879: note = derived and/or modified CDS sequence (opt2) from DENV-1__FJ024436__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagtacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggacgagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgctcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccacctactccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgagaacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgcaagtccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10956 - RNA, 9879 nt, synthetic construct
  misc_feature 1..9879: note = derived and/or modified CDS sequence (opt2) from DENV-1__FJ024472__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccgtcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcatcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10957 - RNA, 9879 nt, synthetic construct
  misc_feature 1..9879: note = derived and/or modified CDS sequence (opt2) from DENV-1__FJ024439__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccttctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcggccgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccaggccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaacatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10958 - RNA, 9879 nt, synthetic construct
  misc_feature 1..9879: note = derived and/or modified CDS sequence (opt2) from DENV-1__FJ024441__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggcgccagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcaccatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcgtctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10959 - RNA, 9879 nt, synthetic construct
  misc_feature 1..9879: note = derived and/or modified CDS sequence (opt2) from DENV-1__FJ024442__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggccgcatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaacctcggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 10960 - RNA, 9879 nt, synthetic construct
  misc_feature 1..9879: note = derived and/or modified CDS sequence (opt2) from DENV-1__FJ373296__SS-prME
  source 1..9879: mol_type = other RNA
tccgtcaccatgctcctcatgctcatgcccatcgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgccacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10961 - RNA, 9879 nt, synthetic construct
  misc_feature 1..9879: note = derived and/or modified CDS sequence (opt2) from DENV-1__FJ182018__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccatcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 10962 - RNA, 9879 nt, synthetic construct
  misc_feature 1..9879: note = derived and/or modified CDS sequence (opt2) from DENV-1__FJ410287__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcacctcccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatcatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 10963 - RNA, 9879 nt, synthetic construct
  misc_feature 1..9879: note = derived and/or modified CDS sequence (opt2) from DENV-1__FJ432719__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccgccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10964 - RNA, 9879 nt, synthetic construct
  misc_feature 1..9879: note = derived and/or modified CDS sequence (opt2) from DENV-1__FJ182020__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10965 - RNA, 9879 nt, synthetic construct
  misc_feature 1..9879: note = derived and/or modified CDS sequence (opt2) from DENV-1__FJ182022__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctccgcggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10966 - RNA, 9879 nt, synthetic construct
  misc_feature 1..9879: note = derived and/or modified CDS sequence (opt2) from DENV-1__FJ024447__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaaggtcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcggccgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaacatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10967 - RNA, 9879 nt, synthetic construct
  misc_feature 1..9879: note = derived and/or modified CDS sequence (opt2) from DENV-1__FJ182025__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcggccgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatcgcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaacatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccaccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccgtcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10968 - RNA, 9879 nt, synthetic construct
  misc_feature 1..9879: note = derived and/or modified CDS sequence (opt2) from DENV-1__FJ373297__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggcctcttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgctcctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgcccgcaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctctccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccaccaaccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgactccgaccccgagggcgccctctggtga

SEQ ID NO: 10969 - RNA, 9879 nt, synthetic construct
  misc_feature 1..9879: note = derived and/or modified CDS sequence (opt2) from DENV-1__FJ024448__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatcacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctccgcggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgcctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10970 - RNA, 9879 nt, synthetic construct
  misc_feature 1..9879: note = derived and/or modified CDS sequence (opt2) from DENV-1__FJ182026__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccagaacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacgccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10971 - RNA, 9879 nt, synthetic construct
  misc_feature 1..9879: note = derived and/or modified CDS sequence (opt2) from DENV-1__FJ182027__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatcacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctccgcggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10972 - RNA, 9879 nt, synthetic construct
  misc_feature 1..9879: note = derived and/or modified CDS sequence (opt2) from DENV-1__FJ024449__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgacgtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcaagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 10973 - RNA, 9879 nt, synthetic construct
  misc_feature 1..9879: note = derived and/or modified CDS sequence (opt2) from DENV-1__FJ390383__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatcatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgagcccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagatccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 10974 - RNA, 9879 nt, synthetic construct
  misc_feature 1..9879: note = derived and/or modified CDS sequence (opt2) from DENV-1__FJ182033__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccatcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgctcctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggcctcggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgcccgcaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10975 - RNA, 9879 nt, synthetic construct
  misc_feature 1..9879: note = derived and/or modified CDS sequence (opt2) from DENV-1__FJ182034__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcatgacctacctcgccctcatggccaccttcaagatgcgccccatgctcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccacctactccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgagaacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10976 - RNA, 9879 nt, synthetic construct
  misc_feature 1..9879: note = derived and/or modified CDS sequence (opt2) from DENV-1__FJ182036__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgccaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatgtcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccaagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10977 - RNA, 9879 nt, synthetic construct
  misc_feature 1..9879: note = derived and/or modified CDS sequence (opt2) from DENV-1__FJ205876__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttcaaccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgcccgctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10978 - RNA, 9879 nt, synthetic construct
  misc_feature 1..9879: note = derived and/or modified CDS sequence (opt2) from DENV-1__FJ024455__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgtcggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccccccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10979 - RNA, 9879 nt, synthetic construct
  misc_feature 1..9879: note = derived and/or modified CDS sequence (opt2) from DENV-1__FJ024456__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcatcctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcatccagaacggccgcctcatcaccgccaaccccatcgtcaccgacaaggagaagcccgtcaacatcgaggccgagccccccttcggcgagtcctacatcgtcatcggcgtcggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggcctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggcatggaggagcccatccccatggccaccaacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 10980 - RNA, 9879 nt, synthetic construct
  misc_feature 1..9879: note = derived and/or modified CDS sequence (opt2) from DENV-1__FJ024457__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgcccgctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccatcctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10981 - RNA, 9879 nt, synthetic construct
  misc_feature 1..9879: note = derived and/or modified CDS sequence (opt2) from DENV-1__FJ205881__SS-prME
  source 1..9879: mol_type = other RNA
tccgtcaccatgctcctcctcctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaagacctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10982 - RNA, 9879 nt, synthetic construct
  misc_feature 1..9879: note = derived and/or modified CDS sequence (opt2) from DENV-1__FJ205882__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggacgagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctggaaggtcgaggaccacggcttcggcatcttccccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgctcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccacctactccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgagaacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgcaagtccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10983 - RNA, 9879 nt, synthetic construct
  misc_feature 1..9879: note = derived and/or modified CDS sequence (opt2) from DENV-1__FJ390388__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcatgacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcgtcggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccgtcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagcgcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10984 - RNA, 9879 nt, synthetic construct
  misc_feature 1..9879: note = derived and/or modified CDS sequence (opt2) from DENV-1__FJ024464__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgtccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatgtcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccaagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10985 - RNA, 9879 nt, synthetic construct
  misc_feature 1..9879: note = derived and/or modified CDS sequence (opt2) from DENV-1__FJ410191__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagcacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccacctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagggcgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagcgcgacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcgtcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatcgaggcccagctcatccgccagatggagtccgaggagatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10986 - RNA, 9879 nt, synthetic construct
  misc_feature 1..9879: note = derived and/or modified CDS sequence (opt2) from DENV-1__FJ432723__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatcgccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccttcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctccccggcgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 10987 - RNA, 9879 nt, synthetic construct
  misc_feature 1..9879: note = derived and/or modified CDS sequence (opt2) from DENV-1__FJ410192__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatgatcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagtcccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10988 - RNA, 9879 nt, synthetic construct
  misc_feature 1..9879: note = derived and/or modified CDS sequence (opt2) from DENV-1__FJ410194__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctcccctccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgagccccgcatcaccgacatcatggagcccgagcacgccctcctcgccaagtccatcttcaagctcacctaccagaacaaggtcgtccgcgtccagtcccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctggtcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcgccaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10989 - RNA, 9879 nt, synthetic construct
  misc_feature 1..9879: note = derived and/or modified CDS sequence (opt2) from DENV-1__FJ432725__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccggcgtcaccggcggcgtcaccctcgtcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgccaagggctggcccatctccaagatggacatcggcgtccccctcctcgccctcggctgctactcccaggtcaaccccctcaccctcaccgcccccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcccccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcggccaccgcgagcgcgagctccacaagcagggcaagtgcgccacctgcgtctccaacatgatgggcaagcgcgagaagaagctcggcgagttcggcaagcccaagggctcccgccccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcctcccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10990 - RNA, 9879 nt, synthetic construct
  misc_feature 1..9879: note = derived and/or modified CDS sequence (opt2) from DENV-1__FJ432729__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgtcatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcgccatgctcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccagaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 10991 - RNA, 9879 nt, synthetic construct
  misc_feature 1..9879: note = derived and/or modified CDS sequence (opt2) from DENV-1__FJ432730__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcatgaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgcccgccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10992 - RNA, 9879 nt, synthetic construct
  misc_feature 1..9879: note = derived and/or modified CDS sequence (opt2) from DENV-1__FJ432732__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgtcatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcaccatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcttcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10993 - RNA, 9879 nt, synthetic construct
  misc_feature 1..9879: note = derived and/or modified CDS sequence (opt2) from DENV-1__FJ432733__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgtcatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcgccatgctcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccagaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 10994 - RNA, 9879 nt, synthetic construct
  misc_feature 1..9879: note = derived and/or modified CDS sequence (opt2) from DENV-1__FJ410196__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccttctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctcctccgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcggcatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10995 - RNA, 9879 nt, synthetic construct
  misc_feature 1..9879: note = derived and/or modified CDS sequence (opt2) from DENV-1__FJ432734__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggtcctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatgttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagaccgaccccgagggcgccctctggtga

SEQ ID NO: 10996 - RNA, 9879 nt, synthetic construct
  misc_feature 1..9879: note = derived and/or modified CDS sequence (opt2) from DENV-1__FJ432735__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagaaggcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10997 - RNA, 9879 nt, synthetic construct
  misc_feature 1..9879: note = derived and/or modified CDS sequence (opt2) from DENV-1__FJ432736__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcatccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacctcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggccccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgccttcgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcatctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggccacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10998 - RNA, 9879 nt, synthetic construct
  misc_feature 1..9879: note = derived and/or modified CDS sequence (opt2) from DENV-1__FJ410198__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcggccgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaacatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 10999 - RNA, 9879 nt, synthetic construct
  misc_feature 1..9879: note = derived and/or modified CDS sequence (opt2) from DENV-1__FJ410199__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagaactacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcctcttcctcctcatcatgggccagctcacctggtccgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgcaagtacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11000 - RNA, 9879 nt, synthetic construct
  misc_feature 1..9879: note = derived and/or modified CDS sequence (opt2) from DENV-1__FJ432739__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaaggcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacgccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcatcctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacaccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagatcgaccccgagggcgccctctggtga

SEQ ID NO: 11001 - RNA, 9879 nt, synthetic construct
  misc_feature 1..9879: note = derived and/or modified CDS sequence (opt2) from DENV-1__FJ410201__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcaactacatgacctccatgaagcgcttcaagaacgagtccgaccccgagggcgccctctggtga

SEQ ID NO: 11002 - RNA, 9879 nt, synthetic construct
  misc_feature 1..9879: note = derived and/or modified CDS sequence (opt2) from DENV-1__FJ410203__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcatccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgccttcgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggccacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11003 - RNA, 9879 nt, synthetic construct
  misc_feature 1..9879: note = derived and/or modified CDS sequence (opt2) from DENV-1__FJ410204__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcatccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtctacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgccttcgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggccacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagaccaagaagctccgccaccgctggcccgacgcccgccagtactccgaccccctcggcctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11004 - RNA, 9879 nt, synthetic construct
  misc_feature 1..9879: note = derived and/or modified CDS sequence (opt2) from DENV-1__FJ432742__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11005 - RNA, 9879 nt, synthetic construct
  misc_feature 1..9879: note = derived and/or modified CDS sequence (opt2) from DENV-1__FJ410205__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgccggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11006 - RNA, 9879 nt, synthetic construct
  misc_feature 1..9879: note = derived and/or modified CDS sequence (opt2) from DENV-1__FJ410207__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcatggtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagctcgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaaccgcatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11007 - RNA, 9879 nt, synthetic construct
  misc_feature 1..9879: note = derived and/or modified CDS sequence (opt2) from DENV-1__FJ432744__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaaggcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacgccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcatcctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcgccgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacaccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagatcgaccccgagggcgccctctggtga

SEQ ID NO: 11008 - RNA, 9879 nt, synthetic construct
  misc_feature 1..9879: note = derived and/or modified CDS sequence (opt2) from DENV-1__FJ547060__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccagaccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcgtccgccagatggagtccgagggcatcttctccccctgcgagctcgagatccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacgtcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11009 - RNA, 9879 nt, synthetic construct
  misc_feature 1..9879: note = derived and/or modified CDS sequence (opt2) from DENV-1__FJ432745__SS-prME
  source 1..9879: mol_type = other RNA
tccgtcaccatgctcctcatgctcatgcccaccgccctcgccttccacctcaccacccgcggcggcgagccccacatggtcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcctcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacgtcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11010 - RNA, 9879 nt, synthetic construct
  misc_feature 1..9879: note = derived and/or modified CDS sequence (opt2) from DENV-1__FJ432746__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaactacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggacaccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcgtccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgtcgtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11011 - RNA, 9879 nt, synthetic construct
  misc_feature 1..9879: note = derived and/or modified CDS sequence (opt2) from DENV-1__FJ432748__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaaggtccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11012 - RNA, 9879 nt, synthetic construct
  misc_feature 1..9879: note = derived and/or modified CDS sequence (opt2) from DENV-1__FJ432749__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagaaggccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcgtcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccttctggtga

SEQ ID NO: 11013 - RNA, 9879 nt, synthetic construct
  misc_feature 1..9879: note = derived and/or modified CDS sequence (opt2) from DENV-1__FJ410212__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgccctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgtccagggcaagaagatgatccgcccccagcccatggagtacaagtactcctggaagtcctggggcaaggccaagatcatcggcgccgacgtccagaactccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatccacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggcacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccatggaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcgtcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctccccaacgagctcgagacccccaacctcgccggccgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgagcccgagggcgccctctggtga

SEQ ID NO: 11014 - RNA, 9879 nt, synthetic construct
  misc_feature 1..9879: note = derived and/or modified CDS sequence (opt2) from DENV-1__FJ461307__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgtccagggcaagaagatgatccgcccccagcccatggagtacaagtactcctggaagtcctggggcaaggccaagatcatcggcgccgacgtccagaactccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatccacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggcacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccatggaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctccccaacgagctcgagacccccaacctcgccggccgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgatctccatgaagcgcttcaagaacgagtccgagcccgagggcgccctctggtga

SEQ ID NO: 11015 - RNA, 9879 nt, synthetic construct
  misc_feature 1..9879: note = derived and/or modified CDS sequence (opt2) from DENV-1__FJ410213__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcgtcgtctccatcctcctctcctccctcctcaaggacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11016 - RNA, 9879 nt, synthetic construct
  misc_feature 1..9879: note = derived and/or modified CDS sequence (opt2) from DENV-1__FJ461308__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctgcatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11017 - RNA, 9879 nt, synthetic construct
  misc_feature 1..9879: note = derived and/or modified CDS sequence (opt2) from DENV-1__FJ461310__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcatcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagcgcaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatcgaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11018 - RNA, 9879 nt, synthetic construct
  misc_feature 1..9879: note = derived and/or modified CDS sequence (opt2) from DENV-1__FJ906728__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcatcctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggccccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcctccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaacaccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcgccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11019 - RNA, 9879 nt, synthetic construct
  misc_feature 1..9879: note = derived and/or modified CDS sequence (opt2) from DENV-1__FJ461313__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgccatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgctccaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcaactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11020 - RNA, 9879 nt, synthetic construct
  misc_feature 1..9879: note = derived and/or modified CDS sequence (opt2) from DENV-1__FJ547063__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatgatcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctccagcgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11021 - RNA, 9879 nt, synthetic construct
  misc_feature 1..9879: note = derived and/or modified CDS sequence (opt2) from DENV-1__FJ410218__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgtcgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagatccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacgtcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11022 - RNA, 9879 nt, synthetic construct
  misc_feature 1..9879: note = derived and/or modified CDS sequence (opt2) from DENV-1__FJ461316__SS-prME
  source 1..9879: mol_type = other RNA
tccgtcaccatgctcctcatgctcatgcccaccgccctcgccttccacctcaccacccgcggcggcgagccccacatggtcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcctcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacgtcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatgggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11023 - RNA, 9879 nt, synthetic construct
  misc_feature 1..9879: note = derived and/or modified CDS sequence (opt2) from DENV-1__FJ410220__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcgtcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgtccagggcaagaagatgatccgcccccagcccatggagtacaagtactcctggaagtcctggggcaaggccaagatcatcggcgccgacgtccagaactccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatccacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggcacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccatggaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctccccaacgagctcgagacccccaacctcgccggccgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgagcccgagggcgccctctggtga

SEQ ID NO: 11024 - RNA, 9879 nt, synthetic construct
  misc_feature 1..9879: note = derived and/or modified CDS sequence (opt2) from DENV-1__JF937649__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgctcctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgcccgcaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctctccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11025 - RNA, 9879 nt, synthetic construct
  misc_feature 1..9879: note = derived and/or modified CDS sequence (opt2) from DENV-1__FJ410222__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccaagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11026 - RNA, 9879 nt, synthetic construct
  misc_feature 1..9879: note = derived and/or modified CDS sequence (opt2) from DENV-1__FJ461319__SS-prME
  source 1..9879: mol_type = other RNA
tccgtcaccatgctcctcatgctcatgcccaccgccctcgccttccacctcaccacccgcggcggcgagccccacatggtcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcctcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacgtcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccgccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacgtccaggtcgccatcaaccaggtccgccgcctcatcggcaacgagaactacctcgactacatgacctccatgaagcgcttcaagaacgagtccgaccccgagggcgccctctggtga

SEQ ID NO: 11027 - RNA, 9879 nt, synthetic construct
  misc_feature 1..9879: note = derived and/or modified CDS sequence (opt2) from DENV-1__FJ461320__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatggtcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatccgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11028 - RNA, 9879 nt, synthetic construct
  misc_feature 1..9879: note = derived and/or modified CDS sequence (opt2) from DENV-1__FJ410225__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccatcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgagatctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgcccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11029 - RNA, 9879 nt, synthetic construct
  misc_feature 1..9879: note = derived and/or modified CDS sequence (opt2) from DENV-1__FJ410226__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggacaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcgtcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcatgtccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11030 - RNA, 9879 nt, synthetic construct
  misc_feature 1..9879: note = derived and/or modified CDS sequence (opt2) from DENV-1__FJ410227__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccaccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11031 - RNA, 9879 nt, synthetic construct
  misc_feature 1..9879: note = derived and/or modified CDS sequence (opt2) from DENV-1__FJ859029__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagcacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagggcgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcgtcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggccaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgaggagatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11032 - RNA, 9879 nt, synthetic construct
  misc_feature 1..9879: note = derived and/or modified CDS sequence (opt2) from DENV-1__FJ547065__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgacctccgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagacccgcaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgcaagtggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11033 - RNA, 9879 nt, synthetic construct
  misc_feature 1..9879: note = derived and/or modified CDS sequence (opt2) from DENV-1__FJ410230__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcatcggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatgtcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctcccgcatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcctcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11034 - RNA, 9879 nt, synthetic construct
  misc_feature 1..9879: note = derived and/or modified CDS sequence (opt2) from DENV-1__FJ410231__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgctcctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgcccgcaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctctccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11035 - RNA, 9879 nt, synthetic construct
  misc_feature 1..9879: note = derived and/or modified CDS sequence (opt2) from DENV-1__FJ461323__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggtcctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagaccgaccccgagggcgccctctggtga

SEQ ID NO: 11036 - RNA, 9879 nt, synthetic construct
  misc_feature 1..9879: note = derived and/or modified CDS sequence (opt2) from DENV-1__FJ461325__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcaccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11037 - RNA, 9879 nt, synthetic construct
  misc_feature 1..9879: note = derived and/or modified CDS sequence (opt2) from DENV-1__FJ410232__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcaccgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11038 - RNA, 9879 nt, synthetic construct
  misc_feature 1..9879: note = derived and/or modified CDS sequence (opt2) from DENV-1__FJ461327__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatgggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11039 - RNA, 9879 nt, synthetic construct
  misc_feature 1..9879: note = derived and/or modified CDS sequence (opt2) from DENV-1__FJ461328__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgtccagggcaagaagatgatccgcccccagcccatggagtacaagtactcctggaagtcctggggcaaggccaagatcatcggcgccgacgtccagaactccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatccacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggcacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccatggaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctccccaacgagctcgagacccccaacctcgccggccgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgagcccgagggcgccctctggtga

SEQ ID NO: 11040 - RNA, 9879 nt, synthetic construct
  misc_feature 1..9879: note = derived and/or modified CDS sequence (opt2) from DENV-1__FJ410234__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctcccctcctccctcgaggagctcggcgacggcctcgccatgggcatcatgatcctcaagctcctcaccgacttccagtcccaccagctctgggccaccctcctctccctcaccttcatcaagaccgccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11041 - RNA, 9879 nt, synthetic construct
  misc_feature 1..9879: note = derived and/or modified CDS sequence (opt2) from DENV-1__FJ410235__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccaccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcgtccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccatcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctcggcaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11042 - RNA, 9879 nt, synthetic construct
  misc_feature 1..9879: note = derived and/or modified CDS sequence (opt2) from DENV-1__FJ410236__SS-prME
  source 1..9879: mol_type = other RNA
tccgtcaccatgctcctcatgctcgtccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccatgaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcaagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11043 - RNA, 9879 nt, synthetic construct
  misc_feature 1..9879: note = derived and/or modified CDS sequence (opt2) from DENV-1__FJ410238__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacacctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgccgagctccccaactccctcgaggagctcggcgacggcctcgccatgggcatcatgatcctcaagctcctcaccgacttccagtcccaccagctctgggccaccctcctctccctcaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgccgcctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgtctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11044 - RNA, 9879 nt, synthetic construct
  misc_feature 1..9879: note = derived and/or modified CDS sequence (opt2) from DENV-1__FJ410239__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgccggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcttcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11045 - RNA, 9879 nt, synthetic construct
  misc_feature 1..9879: note = derived and/or modified CDS sequence (opt2) from DENV-1__FJ410240__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgcccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11046 - RNA, 9879 nt, synthetic construct
  misc_feature 1..9879: note = derived and/or modified CDS sequence (opt2) from DENV-1__FJ410242__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccaccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgctccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11047 - RNA, 9879 nt, synthetic construct
  misc_feature 1..9879: note = derived and/or modified CDS sequence (opt2) from DENV-1__FJ410243__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaaggcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctccgcggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacgccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggccccatgaagatcaaggacgaggagcgcgacgacatgctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccatggaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatcctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacaccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagatcgaccccgagggcgccctctggtga

SEQ ID NO: 11048 - RNA, 9879 nt, synthetic construct
  misc_feature 1..9879: note = derived and/or modified CDS sequence (opt2) from DENV-1__FJ410244__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatgaacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaacctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccatcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtccccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacgtcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11049 - RNA, 9879 nt, synthetic construct
  misc_feature 1..9879: note = derived and/or modified CDS sequence (opt2) from DENV-1__FJ410245__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacatcggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagaagaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11050 - RNA, 9879 nt, synthetic construct
  misc_feature 1..9879: note = derived and/or modified CDS sequence (opt2) from DENV-1__FJ410246__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggacaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgaccgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccacgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagcgccacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11051 - RNA, 9879 nt, synthetic construct
  misc_feature 1..9879: note = derived and/or modified CDS sequence (opt2) from DENV-1__FJ410247__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaaccgcatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccacccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcagggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11052 - RNA, 9879 nt, synthetic construct
  misc_feature 1..9879: note = derived and/or modified CDS sequence (opt2) from DENV-1__FJ410248__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgtcgccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgctcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccacctactccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgagaacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagaaggacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11053 - RNA, 9879 nt, synthetic construct
  misc_feature 1..9879: note = derived and/or modified CDS sequence (opt2) from DENV-1__FJ410249__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcgccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcgtcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcgccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcttcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccaccggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacgtcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11054 - RNA, 9879 nt, synthetic construct
  misc_feature 1..9879: note = derived and/or modified CDS sequence (opt2) from DENV-1__FJ410251__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcggcaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11055 - RNA, 9879 nt, synthetic construct
  misc_feature 1..9879: note = derived and/or modified CDS sequence (opt2) from DENV-1__FJ410252__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccctcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgactaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11056 - RNA, 9879 nt, synthetic construct
  misc_feature 1..9879: note = derived and/or modified CDS sequence (opt2) from DENV-1__FJ461331__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcatccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgccttcgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgtcgtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggccacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11057 - RNA, 9879 nt, synthetic construct
  misc_feature 1..9879: note = derived and/or modified CDS sequence (opt2) from DENV-1__FJ410256__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacaccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccaccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcgtcgcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgccgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgccgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11058 - RNA, 9879 nt, synthetic construct
  misc_feature 1..9879: note = derived and/or modified CDS sequence (opt2) from DENV-1__FJ410257__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcaccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttctccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaactacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgaccgcaagaagctccgcccccgctggctcgacgcccgcacctactccgaccccctcgccctccgcgagctcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11059 - RNA, 9879 nt, synthetic construct
  misc_feature 1..9879: note = derived and/or modified CDS sequence (opt2) from DENV-1__FJ461332__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcatccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgccttcgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgtcgtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggccacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgtcaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11060 - RNA, 9879 nt, synthetic construct
  misc_feature 1..9879: note = derived and/or modified CDS sequence (opt2) from DENV-1__FJ461333__SS-prME
  source 1..9879: mol_type = other RNA
tccgtcaccatgctcctcatgctcatgcccaccgccctcgccttccacctcaccacccgcggcggcgagccccacatggtcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcctcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacgtcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgccgccgtcggcaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacgtccaggtcgccatcaaccaggtccgccgcctcatcggcaacgagaactacctcgactacatgacctccatgaagcgcttcaagaacgagtccgaccccgagggcgccctctggtga

SEQ ID NO: 11061 - RNA, 9879 nt, synthetic construct
  misc_feature 1..9879: note = derived and/or modified CDS sequence (opt2) from DENV-1__FJ410262__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcggcctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11062 - RNA, 9879 nt, synthetic construct
  misc_feature 1..9879: note = derived and/or modified CDS sequence (opt2) from DENV-1__FJ410263__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacatcatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11063 - RNA, 9879 nt, synthetic construct
  misc_feature 1..9879: note = derived and/or modified CDS sequence (opt2) from DENV-1__FJ410264__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcatccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11064 - RNA, 9879 nt, synthetic construct
  misc_feature 1..9879: note = derived and/or modified CDS sequence (opt2) from DENV-1__FJ410265__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcacctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11065 - RNA, 9879 nt, synthetic construct
  misc_feature 1..9879: note = derived and/or modified CDS sequence (opt2) from DENV-1__FJ461336__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcctcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcggccgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaacatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11066 - RNA, 9879 nt, synthetic construct
  misc_feature 1..9879: note = derived and/or modified CDS sequence (opt2) from DENV-1__FJ410266__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtccaagaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatcgccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccttcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggcacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctccccggcgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11067 - RNA, 9879 nt, synthetic construct
  misc_feature 1..9879: note = derived and/or modified CDS sequence (opt2) from DENV-1__FJ410269__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcatccagaacggccgcctcatcaccgccaaccccatcgtcaccgacaaggagaagcccgtcaacatcgaggccgagccccccttcggcgagtcctacatcgtcatcggcgtcggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgtcacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggcctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagatccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11068 - RNA, 9879 nt, synthetic construct
  misc_feature 1..9879: note = derived and/or modified CDS sequence (opt2) from DENV-1__FJ410273__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgtcgccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcacccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgctcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccacctactccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgagaacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11069 - RNA, 9879 nt, synthetic construct
  misc_feature 1..9879: note = derived and/or modified CDS sequence (opt2) from DENV-1__FJ410276__SS-prME
  source 1..9879: mol_type = other RNA
tccgtcaccatgttcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggcccgcgcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11070 - RNA, 9879 nt, synthetic construct
  misc_feature 1..9879: note = derived and/or modified CDS sequence (opt2) from DENV-1__FJ410278__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcatcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagcgcaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11071 - RNA, 9879 nt, synthetic construct
  misc_feature 1..9879: note = derived and/or modified CDS sequence (opt2) from DENV-1__FJ410279__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcctctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcgtctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11072 - RNA, 9879 nt, synthetic construct
  misc_feature 1..9879: note = derived and/or modified CDS sequence (opt2) from DENV-1__FJ410283__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgccggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcggcaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11073 - RNA, 9879 nt, synthetic construct
  misc_feature 1..9879: note = derived and/or modified CDS sequence (opt2) from DENV-1__FJ410284__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcatccagaacggccgcctcatcaccgccaaccccatcgtcaccgacaaggagaagcccgtcaacatcgaggccgagccccccttcggcgagtcctacatcgtcatcggcgtcggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggcctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagaaggacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccaccaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11074 - RNA, 9879 nt, synthetic construct
  misc_feature 1..9879: note = derived and/or modified CDS sequence (opt2) from DENV-1__FJ410285__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgtcatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagcacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctctccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggccccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcgccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgccgcctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11075 - RNA, 9879 nt, synthetic construct
  misc_feature 1..9879: note = derived and/or modified CDS sequence (opt2) from DENV-1__FJ410286__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgagaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacggcaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgtccagggcaagaagatgatccgcccccagcccatggagtacaagtactcctggaagtcctggggcaaggccaagatcatcggcgccgacgtccagaactccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatccacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggcacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcttccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccatggaggccttcccccagtccaacgccgtcatccaggacgaggagcgcgacatccccgagcgctcctggaactccggctacgagtggatcaccgacttccccggcaagaccgtctggttcgtcccctccatcaaggccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccatcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgaccgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctccccaacgagctcgagacccccaacctcgccggccgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccgcatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactactccgactacatgacctccatgaagcgcttcaagaacgagtccgagcccgagggcgccctctggtga

SEQ ID NO: 11076 - RNA, 9879 nt, synthetic construct
  misc_feature 1..9879: note = derived and/or modified CDS sequence (opt2) from DENV-1__FJ461339__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagccccaccagctctgggccaccctcctctccctcaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgccgcctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatcgcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgtcggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacctccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11077 - RNA, 9879 nt, synthetic construct
  misc_feature 1..9879: note = derived and/or modified CDS sequence (opt2) from DENV-1__FJ882515__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccatcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagatgcgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcatccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagaaggacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgtccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggccccaggtcccccactgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgaggacgaccccgagggcgccctctggtga

SEQ ID NO: 11078 - RNA, 9879 nt, synthetic construct
  misc_feature 1..9879: note = derived and/or modified CDS sequence (opt2) from DENV-1__FJ882517__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgaggaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggtcaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacaccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11079 - RNA, 9879 nt, synthetic construct
  misc_feature 1..9879: note = derived and/or modified CDS sequence (opt2) from DENV-1__JQ287661__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccatcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacgtcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagatgcgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcatccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagaaggacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgtccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtcaagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11080 - RNA, 9879 nt, synthetic construct
  misc_feature 1..9879: note = derived and/or modified CDS sequence (opt2) from DENV-1__FJ882518__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggcccctccacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgcctccctcttccccctctgcctctccaccacctcccagaagaccacctggctccccgtcctcctcggctccctcggctgcaagcccctcaccatgttcctcatcaccgagaccaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgtcgtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11081 - RNA, 9879 nt, synthetic construct
  misc_feature 1..9879: note = derived and/or modified CDS sequence (opt2) from DENV-1__FJ882519__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgccgccacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11082 - RNA, 9879 nt, synthetic construct
  misc_feature 1..9879: note = derived and/or modified CDS sequence (opt2) from DENV-1__FJ882520__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgctcctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgcccgcaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctctccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11083 - RNA, 9879 nt, synthetic construct
  misc_feature 1..9879: note = derived and/or modified CDS sequence (opt2) from DENV-1__FJ882523__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacgaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagatccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacgtcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11084 - RNA, 9879 nt, synthetic construct
  misc_feature 1..9879: note = derived and/or modified CDS sequence (opt2) from DENV-1__FJ882524__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaactacgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcaccgcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagatccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacgtcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11085 - RNA, 9879 nt, synthetic construct
  misc_feature 1..9879: note = derived and/or modified CDS sequence (opt2) from DENV-1__FJ882525__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcgtcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatccgctacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatcggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacttcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcgcatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11086 - RNA, 9879 nt, synthetic construct
  misc_feature 1..9879: note = derived and/or modified CDS sequence (opt2) from DENV-1__FJ882526__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagcgcgccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctccgccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11087 - RNA, 9879 nt, synthetic construct
  misc_feature 1..9879: note = derived and/or modified CDS sequence (opt2) from DENV-1__FJ882527__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgctcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcgccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11088 - RNA, 9879 nt, synthetic construct
  misc_feature 1..9879: note = derived and/or modified CDS sequence (opt2) from DENV-1__FJ882529__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacgtcaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggtccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11089 - RNA, 9879 nt, synthetic construct
  misc_feature 1..9879: note = derived and/or modified CDS sequence (opt2) from DENV-1__FJ882530__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11090 - RNA, 9879 nt, synthetic construct
  misc_feature 1..9879: note = derived and/or modified CDS sequence (opt2) from DENV-1__GQ868605__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgtcggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgtcggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgacacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctccatctccatcatgatcgaggaggtcatgcgctcccgctggtcccgcaagatgctcatgaccggcaccctcgccgtcttcctcctcctcatcgtcggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccgccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgagaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggctccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcatcgagatcggcaagctcccccagcacctcacccagaaggcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggtccttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11091 - RNA, 9879 nt, synthetic construct
  misc_feature 1..9879: note = derived and/or modified CDS sequence (opt2) from DENV-1__FJ882534__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggcccccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgtcgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11092 - RNA, 9879 nt, synthetic construct
  misc_feature 1..9879: note = derived and/or modified CDS sequence (opt2) from DENV-1__FJ882536__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11093 - RNA, 9879 nt, synthetic construct
  misc_feature 1..9879: note = derived and/or modified CDS sequence (opt2) from DENV-1__FJ882537__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagaccaccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcatcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgtcgtcggcatcctcgcccagggcaagaagatggtccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgctcctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcacatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11094 - RNA, 9879 nt, synthetic construct
  misc_feature 1..9879: note = derived and/or modified CDS sequence (opt2) from DENV-1__GQ868606__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaaccaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgcccgcaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11095 - RNA, 9879 nt, synthetic construct
  misc_feature 1..9879: note = derived and/or modified CDS sequence (opt2) from DENV-1__FJ882539__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgccctcgcctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcatcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaaccaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11096 - RNA, 9879 nt, synthetic construct
  misc_feature 1..9879: note = derived and/or modified CDS sequence (opt2) from DENV-1__FJ882541__SS-prME
  source 1..9879: mol_type = other RNA
tccgtcaccatgctcctcatgctcatccccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaagggcaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgctcctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgcccgcaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctctccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11097 - RNA, 9879 nt, synthetic construct
  misc_feature 1..9879: note = derived and/or modified CDS sequence (opt2) from DENV-1__FJ882542__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggcccctccacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgcctccctcttccccctctgcctctccaccacctcccagaagaccacctggctccccgtcctcctcggctccctcggctgcaagcccctcaccatgttcctcatcaccgagaccaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgtcgtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcatgaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11098 - RNA, 9879 nt, synthetic construct
  misc_feature 1..9879: note = derived and/or modified CDS sequence (opt2) from DENV-1__FJ882543__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccatcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagatgcgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaaccaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccgccctcctctccctcaccttcatcaagaccaccctctccctccactacgcctggaagaccatggccatggtcctctccatcgtctccctcatccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttcctcggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagaaggacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgtccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtcaagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11099 - RNA, 9879 nt, synthetic construct
  misc_feature 1..9879: note = derived and/or modified CDS sequence (opt2) from DENV-1__FJ882544__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggcaaccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaagggcaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcggccgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaacatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11100 - RNA, 9879 nt, synthetic construct
  misc_feature 1..9879: note = derived and/or modified CDS sequence (opt2) from DENV-1__FJ898371__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccagaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggagaacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11101 - RNA, 9879 nt, synthetic construct
  misc_feature 1..9879: note = derived and/or modified CDS sequence (opt2) from DENV-1__FJ882545__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcggcaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11102 - RNA, 9879 nt, synthetic construct
  misc_feature 1..9879: note = derived and/or modified CDS sequence (opt2) from DENV-1__FJ898372__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggcccgcgacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11103 - RNA, 9879 nt, synthetic construct
  misc_feature 1..9879: note = derived and/or modified CDS sequence (opt2) from DENV-1__FJ898373__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagaccaccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcatcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccgtcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgtcgtcggcatcctcgcccagggcaagaagatggtccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgctcctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcacatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11104 - RNA, 9879 nt, synthetic construct
  misc_feature 1..9879: note = derived and/or modified CDS sequence (opt2) from DENV-1__FJ898374__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcatccagaacggccgcctcatcaccgccaaccccatcgtcaccgacaaggagaagcccgtcaacatcgaggccgagccccccttcggcgagtcctacatcgtcatcggcgtcggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgtcacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggcctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11105 - RNA, 9879 nt, synthetic construct
  misc_feature 1..9879: note = derived and/or modified CDS sequence (opt2) from DENV-1__FJ898375__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatggccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcccacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaagcaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11106 - RNA, 9879 nt, synthetic construct
  misc_feature 1..9879: note = derived and/or modified CDS sequence (opt2) from DENV-1__FJ898376__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgtcatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcgccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccagaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccaactgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11107 - RNA, 9879 nt, synthetic construct
  misc_feature 1..9879: note = derived and/or modified CDS sequence (opt2) from DENV-1__FJ898379__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgtcatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11108 - RNA, 9879 nt, synthetic construct
  misc_feature 1..9879: note = derived and/or modified CDS sequence (opt2) from DENV-1__GQ199773__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcaccgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctggaacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11109 - RNA, 9879 nt, synthetic construct
  misc_feature 1..9879: note = derived and/or modified CDS sequence (opt2) from DENV-1__JF937596__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcatccagaacggccgcctcatcaccgccaaccccatcgtcaccgacaaggagaagcccgtcaacatcgaggccgagccccccttcggcgagtcctacatcgtcatcggcgtcggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggcctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccagaccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggccacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11110 - RNA, 9879 nt, synthetic construct
  misc_feature 1..9879: note = derived and/or modified CDS sequence (opt2) from DENV-1__FJ898380__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11111 - RNA, 9879 nt, synthetic construct
  misc_feature 1..9879: note = derived and/or modified CDS sequence (opt2) from DENV-1__FJ898382__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccttctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctcctccgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11112 - RNA, 9879 nt, synthetic construct
  misc_feature 1..9879: note = derived and/or modified CDS sequence (opt2) from DENV-1__FJ898383__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccatcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11113 - RNA, 9879 nt, synthetic construct
  misc_feature 1..9879: note = derived and/or modified CDS sequence (opt2) from DENV-1__FJ898384__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccatcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgccgcctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11114 - RNA, 9879 nt, synthetic construct
  misc_feature 1..9879: note = derived and/or modified CDS sequence (opt2) from DENV-1__FJ898385__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcggcgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatgatcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacatgggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagatccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacgtcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11115 - RNA, 9879 nt, synthetic construct
  misc_feature 1..9879: note = derived and/or modified CDS sequence (opt2) from DENV-1__GQ868608__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaaggcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctggaaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacgccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacatgctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacaccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagatcgaccccgagggcgccctctggtga

SEQ ID NO: 11116 - RNA, 9879 nt, synthetic construct
  misc_feature 1..9879: note = derived and/or modified CDS sequence (opt2) from DENV-1__GQ199774__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagaccaccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcatcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgtcgtcggcatcctcgcccagggcaagaagatggtccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtccgcgagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgctcctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcacatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11117 - RNA, 9879 nt, synthetic construct
  misc_feature 1..9879: note = derived and/or modified CDS sequence (opt2) from DENV-1__GQ199775__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccatcgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagaccaccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcatcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgtcgtcggcatcctcgcccagggcaagaagatggtccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtccgcgagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgctcctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcacatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctggacccgcgaggaggtcacccgcaaggtccgctccaacgccggcatcggcgccggcgtcggcgacgagaaccagtggaactccgccaagaagggcgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11118 - RNA, 9876 nt, synthetic construct
  misc_feature 1..9876: note = derived and/or modified CDS sequence (opt2) from DENV-1__FJ882546__SS-prME
  source 1..9876: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgcaagtccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgagctccacctcggccagcagcgcgtcttcaaggagaaggtcgacacccgcaccccccgcgccaagcgcggcaccgcccagatcatggagatgaccgcccgctggctctggggcttcctctcccgcaacaagatcccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgaggagatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11119 - RNA, 9879 nt, synthetic construct
  misc_feature 1..9879: note = derived and/or modified CDS sequence (opt2) from DENV-1__KF921935__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaaggagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11120 - RNA, 9879 nt, synthetic construct
  misc_feature 1..9879: note = derived and/or modified CDS sequence (opt2) from DENV-1__GQ199776__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgtcgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11121 - RNA, 9879 nt, synthetic construct
  misc_feature 1..9879: note = derived and/or modified CDS sequence (opt2) from DENV-1__GQ199777__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgtcatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggcctcttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcgccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgccgcctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11122 - RNA, 9879 nt, synthetic construct
  misc_feature 1..9879: note = derived and/or modified CDS sequence (opt2) from DENV-1__GQ199778__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggaggcctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccatcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11123 - RNA, 9879 nt, synthetic construct
  misc_feature 1..9879: note = derived and/or modified CDS sequence (opt2) from DENV-1__GQ199780__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctccgccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacgtcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11124 - RNA, 9879 nt, synthetic construct
  misc_feature 1..9879: note = derived and/or modified CDS sequence (opt2) from DENV-1__GQ199781__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcatccagaacggccgcctcatcaccgccaaccccatcgtcaccgacaaggagaagcccgtcaacatcgaggccgagccccccttcggcgagtcctacatcgtcatcggcgtcggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggcctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccagaccaaggcctcccaggagggccccctccccgagatcgaggacgaggtcttccgcaagcgcaacctcaccatcatggacctccaccccggctccggcaagacccgccgctacctccccgccatcatccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcgccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggcccgccgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11125 - RNA, 9879 nt, synthetic construct
  misc_feature 1..9879: note = derived and/or modified CDS sequence (opt2) from DENV-1__GQ199782__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacatccagaacaccaccttcatcatcgacggccccaacacccccgagtgccccgacgaccagcgcgcctggaacatctgggaggtcgaggactacggcttcggcatcttcaccaccaacatctggctccgcctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatggtcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatccgccccatgttcgccgtcggcctcctcgtccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatgaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11126 - RNA, 9879 nt, synthetic construct
  misc_feature 1..9879: note = derived and/or modified CDS sequence (opt2) from DENV-1__GQ199783__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcacctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctcctccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatccgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccaccacgcctggaagaccatggccatggtcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccagaccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11127 - RNA, 9879 nt, synthetic construct
  misc_feature 1..9879: note = derived and/or modified CDS sequence (opt2) from DENV-1__GQ199784__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgtcatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcctcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcgccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccagaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11128 - RNA, 9879 nt, synthetic construct
  misc_feature 1..9879: note = derived and/or modified CDS sequence (opt2) from DENV-1__GQ199785__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgctcctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatgaagcccgagcacgccctcctcgccacctccatcttcaagctcacctaccagaacaaggtcgtccgcgtccagcgccccgcccgcaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctctccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11129 - RNA, 9879 nt, synthetic construct
  misc_feature 1..9879: note = derived and/or modified CDS sequence (opt2) from DENV-1__GQ199786__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcatcctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgcccgctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11130 - RNA, 9879 nt, synthetic construct
  misc_feature 1..9879: note = derived and/or modified CDS sequence (opt2) from DENV-1__GQ199787__SS-prME
  source 1..9879: mol_type = other RNA
tccgtcaccatgctcctcatgctcgtccccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcatccagaacggccgcctcatcaccgccaaccccatcgtcaccgacaaggagaagcccgtcaacatcgaggccgagccccccttcggcgagtcctacatcgtcatcggcgtcggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggcctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcctctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaacgaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11131 - RNA, 9879 nt, synthetic construct
  misc_feature 1..9879: note = derived and/or modified CDS sequence (opt2) from DENV-1__GQ199788__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgcccgccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11132 - RNA, 9879 nt, synthetic construct
  misc_feature 1..9879: note = derived and/or modified CDS sequence (opt2) from DENV-1__GQ199789__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagcacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcacctcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccacctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagggcgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcgtcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatcgaggcccagctcatccgccagatggagtccgaggagatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11133 - RNA, 9879 nt, synthetic construct
  misc_feature 1..9879: note = derived and/or modified CDS sequence (opt2) from DENV-1__GQ199790__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgtcatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcgccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccagaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11134 - RNA, 9879 nt, synthetic construct
  misc_feature 1..9879: note = derived and/or modified CDS sequence (opt2) from DENV-1__GQ199791__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcgtcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccttctggtga

SEQ ID NO: 11135 - RNA, 9879 nt, synthetic construct
  misc_feature 1..9879: note = derived and/or modified CDS sequence (opt2) from DENV-1__GQ199792__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacgcctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacatgggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccggcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11136 - RNA, 9879 nt, synthetic construct
  misc_feature 1..9879: note = derived and/or modified CDS sequence (opt2) from DENV-1__GQ199793__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgccaccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccagatgtgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacgccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggccacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagtacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11137 - RNA, 9879 nt, synthetic construct
  misc_feature 1..9879: note = derived and/or modified CDS sequence (opt2) from DENV-1__GQ199795__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggaccccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11138 - RNA, 9873 nt, synthetic construct
  misc_feature 1..9873: note = derived and/or modified CDS sequence (opt2) from DENV-1__FJ882547__SS-prME
  source 1..9873: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatcggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatgctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagggcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatgtcccccatcgccatgaccgacaccacccccctcgcccagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgaggagatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11139 - RNA, 9879 nt, synthetic construct
  misc_feature 1..9879: note = derived and/or modified CDS sequence (opt2) from DENV-1__GQ199797__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccatgatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgcccgccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11140 - RNA, 9879 nt, synthetic construct
  misc_feature 1..9879: note = derived and/or modified CDS sequence (opt2) from DENV-1__GQ199799__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagccccaccagctctgggccaccctcctctccctcaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgccgcctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11141 - RNA, 9879 nt, synthetic construct
  misc_feature 1..9879: note = derived and/or modified CDS sequence (opt2) from DENV-1__GQ199800__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11142 - RNA, 9879 nt, synthetic construct
  misc_feature 1..9879: note = derived and/or modified CDS sequence (opt2) from DENV-1__FJ882548__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcatccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgccttcgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggccacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11143 - RNA, 9879 nt, synthetic construct
  misc_feature 1..9879: note = derived and/or modified CDS sequence (opt2) from DENV-1__GQ199801__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcacccgcctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcaacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtccaagaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgctcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccacctactccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgagaacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatccccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11144 - RNA, 9879 nt, synthetic construct
  misc_feature 1..9879: note = derived and/or modified CDS sequence (opt2) from DENV-1__GQ199802__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctgggtcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11145 - RNA, 9879 nt, synthetic construct
  misc_feature 1..9879: note = derived and/or modified CDS sequence (opt2) from DENV-1__JF937597__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgccatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcaactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11146 - RNA, 9879 nt, synthetic construct
  misc_feature 1..9879: note = derived and/or modified CDS sequence (opt2) from DENV-1__GQ868609__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctccgcctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagaaggacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11147 - RNA, 9879 nt, synthetic construct
  misc_feature 1..9879: note = derived and/or modified CDS sequence (opt2) from DENV-1__GQ199803__SS-prME
  source 1..9879: mol_type = other RNA
tccgtcaccatgctcctcatgctcatgcccaccgccctcgccttccacctcaccatccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctcccctcctccctcgaggagctcggcgacggcctcgccatgggcatcatgatcctcaagctcctcaccgacttccagtcccaccagctctgggccaccctcctctccctcaccttcatcaagaccgccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgaccgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11148 - RNA, 9879 nt, synthetic construct
  misc_feature 1..9879: note = derived and/or modified CDS sequence (opt2) from DENV-1__GQ199804__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgtcatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgacgccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11149 - RNA, 9879 nt, synthetic construct
  misc_feature 1..9879: note = derived and/or modified CDS sequence (opt2) from DENV-1__GQ199805__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgtcatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcctcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcacccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcgccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccagaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11150 - RNA, 9879 nt, synthetic construct
  misc_feature 1..9879: note = derived and/or modified CDS sequence (opt2) from DENV-1__GQ199806__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccatcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggccgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgtcgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggacggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctcaactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagtacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11151 - RNA, 9879 nt, synthetic construct
  misc_feature 1..9879: note = derived and/or modified CDS sequence (opt2) from DENV-1__GQ199809__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcatccagaacggccgcctcatcaccgccaaccccatcgtcaccgacaaggagaagcccgtcaacatcgaggccgagccccccttcggcgagtcctacatcgtcatcggcgtcggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgtcacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggcctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatggtcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccaactgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11152 - RNA, 9879 nt, synthetic construct
  misc_feature 1..9879: note = derived and/or modified CDS sequence (opt2) from DENV-1__GQ199810__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcatcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcccacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggtcgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgagatcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11153 - RNA, 9879 nt, synthetic construct
  misc_feature 1..9879: note = derived and/or modified CDS sequence (opt2) from DENV-1__GQ199811__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaactacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcgtccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgtcgtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11154 - RNA, 9879 nt, synthetic construct
  misc_feature 1..9879: note = derived and/or modified CDS sequence (opt2) from DENV-1__FJ882549__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggtcgagcccgacgacgtcgactgctggtgcaacaccaccgacacctgggtcacctacggcacctgctcccagaccggcgagcaccgccgcgacaagcgctccgtcgccctcgccccccacgtcggcctcggcctcgagacccgcgccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggcgccagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgctcctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcctaccagctctgggccaccctcctctccctcaccttcatcaagaccaccttctccctccactacgcctggaagaccatggccatggtcctctccatcgtctccctcctccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggccgcgagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggcaagggcctcggcaagacctccatcggcctcctctgcgtcatggcctcctccgccctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctccgccgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcctcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgcccgcaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctctccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11155 - RNA, 9879 nt, synthetic construct
  misc_feature 1..9879: note = derived and/or modified CDS sequence (opt2) from DENV-1__GQ199814__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggacaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgaccgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacgtctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11156 - RNA, 9879 nt, synthetic construct
  misc_feature 1..9879: note = derived and/or modified CDS sequence (opt2) from DENV-1__GQ199816__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagaaggtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaaggcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacgccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcatcctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacaccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagatcgaccccgagggcgccctctggtga

SEQ ID NO: 11157 - RNA, 9879 nt, synthetic construct
  misc_feature 1..9879: note = derived and/or modified CDS sequence (opt2) from DENV-1__GQ199817__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatccgcaccaccttctccctccactacgcctggaagaccatggccatggtcctctccatcgtctccctcatccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtgcttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgccgcctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcctcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11158 - RNA, 9879 nt, synthetic construct
  misc_feature 1..9879: note = derived and/or modified CDS sequence (opt2) from DENV-1__FJ882550__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcatgaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11159 - RNA, 9879 nt, synthetic construct
  misc_feature 1..9879: note = derived and/or modified CDS sequence (opt2) from DENV-1__FJ882551__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccacctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatcggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgtcgtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcccacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcaggagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcaagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagctcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11160 - RNA, 9879 nt, synthetic construct
  misc_feature 1..9879: note = derived and/or modified CDS sequence (opt2) from DENV-1__FJ882552__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccacctcctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaaccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgcccgccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11161 - RNA, 9879 nt, synthetic construct
  misc_feature 1..9879: note = derived and/or modified CDS sequence (opt2) from DENV-1__FJ882553__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttccgcaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgagcccgagggcgccctctggtga

SEQ ID NO: 11162 - RNA, 9879 nt, synthetic construct
  misc_feature 1..9879: note = derived and/or modified CDS sequence (opt2) from DENV-1__FJ882554__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctactccatcgccgcccgcggctacatctccacccgcgtcggcatgggcgaggccgccgccatcttcatgaccgccaccccccccggctccgtcgaggccttcccccagtccaacgccgtcatcaaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11163 - RNA, 9879 nt, synthetic construct
  misc_feature 1..9879: note = derived and/or modified CDS sequence (opt2) from DENV-1__GQ868610__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcatcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatcgccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccttcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11164 - RNA, 9879 nt, synthetic construct
  misc_feature 1..9879: note = derived and/or modified CDS sequence (opt2) from DENV-1__GQ868611__SS-prME
  source 1..9879: mol_type = other RNA
tccgtcaccatgttcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggcccgcgcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11165 - RNA, 9879 nt, synthetic construct
  misc_feature 1..9879: note = derived and/or modified CDS sequence (opt2) from DENV-1__FJ882555__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccgcctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccagaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccatgaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgtcgtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaaggtcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgccctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11166 - RNA, 9879 nt, synthetic construct
  misc_feature 1..9879: note = derived and/or modified CDS sequence (opt2) from DENV-1__GQ199821__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgtcgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgccctcctctggatcgcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11167 - RNA, 9879 nt, synthetic construct
  misc_feature 1..9879: note = derived and/or modified CDS sequence (opt2) from DENV-1__FJ882556__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtctccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11168 - RNA, 9879 nt, synthetic construct
  misc_feature 1..9879: note = derived and/or modified CDS sequence (opt2) from DENV-1__GQ199822__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggccgcgccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcaccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccctcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11169 - RNA, 9879 nt, synthetic construct
  misc_feature 1..9879: note = derived and/or modified CDS sequence (opt2) from DENV-1__FJ882557__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcatccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgccttcgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggccacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccatgaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11170 - RNA, 9879 nt, synthetic construct
  misc_feature 1..9879: note = derived and/or modified CDS sequence (opt2) from DENV-1__FJ882558__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcaccgtctccggcgtctaccccctctccatccccgccaccctcttcgtctggtacttctggcagaagaagaagcagcgctccggcgtcctctgggacaccccctccccccccaaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccatgatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgcccgccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11171 - RNA, 9879 nt, synthetic construct
  misc_feature 1..9879: note = derived and/or modified CDS sequence (opt2) from DENV-1__GQ199824__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatcctcaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11172 - RNA, 9879 nt, synthetic construct
  misc_feature 1..9879: note = derived and/or modified CDS sequence (opt2) from DENV-1__FJ882559__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggcccgcatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctccgcctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcgtccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcatgacctacctcgccctcatggccaccttcaagatgcgccccatgttcgccgtcggcctcctcttccgccgcctcacctcccgcgaggtcctcctcctcaccatcggcctctccctcgtcgcctccgccgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtccgcctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgtccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11173 - RNA, 9879 nt, synthetic construct
  misc_feature 1..9879: note = derived and/or modified CDS sequence (opt2) from DENV-1__GQ199828__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcgtctggcccaagtcccacaccctctggtccaacggcgtccgcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgatcggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaagaacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccgcggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccgtcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgaggagatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgacaaggccatcggctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11174 - RNA, 9879 nt, synthetic construct
  misc_feature 1..9879: note = derived and/or modified CDS sequence (opt2) from DENV-1__GQ199829__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccctcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggccccgctcccacaccctctggtccaacggcgtcctcgagtccgagatgatcatccccaagatctacggcggccccatctcccagcacaactaccgccccggctacttcacccaggccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgccgcatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggcccgcatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactggatccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11175 - RNA, 9879 nt, synthetic construct
  misc_feature 1..9879: note = derived and/or modified CDS sequence (opt2) from DENV-1__FJ882562__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcctcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttccgcggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatgacctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcaccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaaggccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccgagcgcgccctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctgggaggacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11176 - RNA, 9879 nt, synthetic construct
  misc_feature 1..9879: note = derived and/or modified CDS sequence (opt2) from DENV-1__FJ882564__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacggcatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcacctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatggtcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11177 - RNA, 9879 nt, synthetic construct
  misc_feature 1..9879: note = derived and/or modified CDS sequence (opt2) from DENV-1__FJ882565__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcggctcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11178 - RNA, 9879 nt, synthetic construct
  misc_feature 1..9879: note = derived and/or modified CDS sequence (opt2) from DENV-1__FJ882567__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacggcatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcacctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11179 - RNA, 9879 nt, synthetic construct
  misc_feature 1..9879: note = derived and/or modified CDS sequence (opt2) from DENV-1__GQ199831__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgagaccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagtacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgaccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11180 - RNA, 9879 nt, synthetic construct
  misc_feature 1..9879: note = derived and/or modified CDS sequence (opt2) from DENV-1__GQ199832__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacggcatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcacctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctacaagcacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatcatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11181 - RNA, 9879 nt, synthetic construct
  misc_feature 1..9879: note = derived and/or modified CDS sequence (opt2) from DENV-1__FJ882568__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccgtcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttcctcacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacggcatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcacctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatcatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11182 - RNA, 9879 nt, synthetic construct
  misc_feature 1..9879: note = derived and/or modified CDS sequence (opt2) from DENV-1__FJ882569__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacggcatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcacctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgccgctcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11183 - RNA, 9879 nt, synthetic construct
  misc_feature 1..9879: note = derived and/or modified CDS sequence (opt2) from DENV-1__GQ199833__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgaccgccgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaagggcaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacggcatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11184 - RNA, 9879 nt, synthetic construct
  misc_feature 1..9879: note = derived and/or modified CDS sequence (opt2) from DENV-1__FJ882570__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacggcaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacggcatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcacctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcttcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgccctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatcatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11185 - RNA, 9879 nt, synthetic construct
  misc_feature 1..9879: note = derived and/or modified CDS sequence (opt2) from DENV-1__GQ199834__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggagctcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacggcatgaagttcaccgtcgtcgtcggcgacgtcgacggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11186 - RNA, 9879 nt, synthetic construct
  misc_feature 1..9879: note = derived and/or modified CDS sequence (opt2) from DENV-1__GQ199835__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcaccctcatggccaccttcaagatgcgccccatgttcgccgtcggcctcctcctccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11187 - RNA, 9879 nt, synthetic construct
  misc_feature 1..9879: note = derived and/or modified CDS sequence (opt2) from DENV-1__FJ898386__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctgggaggacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccttctggtga

SEQ ID NO: 11188 - RNA, 9879 nt, synthetic construct
  misc_feature 1..9879: note = derived and/or modified CDS sequence (opt2) from DENV-1__FJ898387__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacaccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11189 - RNA, 9879 nt, synthetic construct
  misc_feature 1..9879: note = derived and/or modified CDS sequence (opt2) from DENV-1__FJ898389__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcttcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccttcggctgcaagcccctcgccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgaccccttctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11190 - RNA, 9879 nt, synthetic construct
  misc_feature 1..9879: note = derived and/or modified CDS sequence (opt2) from DENV-1__FJ898390__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgtcggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11191 - RNA, 9879 nt, synthetic construct
  misc_feature 1..9879: note = derived and/or modified CDS sequence (opt2) from DENV-1__FJ898391__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagaccgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11192 - RNA, 9879 nt, synthetic construct
  misc_feature 1..9879: note = derived and/or modified CDS sequence (opt2) from DENV-1__FJ898392__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacggcatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcacctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatcatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11193 - RNA, 9879 nt, synthetic construct
  misc_feature 1..9879: note = derived and/or modified CDS sequence (opt2) from DENV-1__FJ898393__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggccgcgcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgcctccctcttccccctctgcctctccaccacctcccagaagaccacctggctccccgtcctcctcggctccctcggctgcaagcccctcaccatgttcctcatcaccgagaccaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgtcgtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11194 - RNA, 9879 nt, synthetic construct
  misc_feature 1..9879: note = derived and/or modified CDS sequence (opt2) from DENV-1__FJ898394__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccaccccccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgtctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatgacccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11195 - RNA, 9879 nt, synthetic construct
  misc_feature 1..9879: note = derived and/or modified CDS sequence (opt2) from DENV-1__GQ199838__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccctcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacggcatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcacctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatcatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11196 - RNA, 9879 nt, synthetic construct
  misc_feature 1..9879: note = derived and/or modified CDS sequence (opt2) from DENV-1__FJ898396__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccgtcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgcctccctcttccccctctgcctctccaccacctcccagaagaccacctggctccccgtcctcctcggctccctcggctgcaagcccctcaccatgttcctcatcaccgagaccaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgtcgtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcaccctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11197 - RNA, 9879 nt, synthetic construct
  misc_feature 1..9879: note = derived and/or modified CDS sequence (opt2) from DENV-1__GQ199839__SS-prME
  source 1..9879: mol_type = other RNA
tccgtcaccatgctcctcatgctcatgcccaccgccctcgccttccacctcaccacccgcggcggcgagccccacatgatcgtcaccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccgcaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcatggaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccacctccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacggcctcaagttcaccgtcgtcgtcggcgacgtcgtcggcatcctcgcccagggcaagaagatgatccgcccccagcccatggagcacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcacctccatcatgatcgaggaggtcatgcgctcccgctggtcccgcaagatgctcatgaccggcaccctcgccgtcttcctcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccctctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcgtcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcttcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgccctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacccccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccagaccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatcatcctcaccgtcgccgccaacgagatgggcctcctcgagaccaccaagaaggacctcggcatcggccacgtcgccgtcgagaaccaccaccacgccaccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacatctacaagcgctccggcatcatggaggtcgaccgctccgaggccaaggagggcctcaagcgcggcgagaccacccgccacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcaccccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgcccgctggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccagaaggagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttcctcccctccgagctcgagacccccaacctcgccgagcgcgtcctcgactggctcgagaagtacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggcctccaacatccaggtcgccatcaaccaggtccgccgcctcatcggcaacgagaactacctcgactacatgacctccatgaagcgcttcaagaacgagggcgaccccgagggcgccctctggtga

SEQ ID NO: 11198 - RNA, 9879 nt, synthetic construct
  misc_feature 1..9879: note = derived and/or modified CDS sequence (opt2) from DENV-1__FJ898397__SS-prME
  source 1..9879: mol_type = other RNA
tccgtcaccatgctcctcatgctcatgcccaccgccctcgccttccacctcaccatccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccacctccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11199 - RNA, 9879 nt, synthetic construct
  misc_feature 1..9879: note = derived and/or modified CDS sequence (opt2) from DENV-1__FJ898398__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcgcccagggcaagaagatgatccgcccccagcccatggagtacaagtactcctggaagatctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatccgcaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgccgcctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagtccatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcaactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacgtctcctcctggggcgacgtcccctacctcggcaagcgcgaggaccagtggtgcggctccctcatcggcctcaccgcccgcgccacctgggccaccaacatccaggtcgccatcaaccaggtccgccgcctcctcggcaacgagaactacctcgactacatgacctccatgaagcgcttcaagaacgagtccgaccccgagggcgccctctggtga

SEQ ID NO: 11200 - RNA, 9879 nt, synthetic construct
  misc_feature 1..9879: note = derived and/or modified CDS sequence (opt2) from DENV-1__FJ898399__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagctcaccgtcgtcgtcggcgacgtcgccggcatcctcggccagggcaagaagatgatccgcccccagcccatggagtacaagtactcctggaagtcctggggcaaggccaagatcatcggcgccgacgcccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacgagcactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggaggaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggtacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccagggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgccgccacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga

SEQ ID NO: 11201 - RNA, 9879 nt, synthetic construct
  misc_feature 1..9879: note = derived and/or modified CDS sequence (opt2) from DENV-1__FJ898401__SS-prME
  source 1..9879: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagttctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggccccctccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgcaaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggccgactccggctgcgtcatcaactggaagggccgcgagctcaagtgcggctccggcatcttcgtcaccaacgaggtccacacctggaccgagcagtacaagttccaggccgactcccccaagcgcctctccgccgccatcggcaaggcctgggaggagggcgtctgcggcatccgctccgccacccgcctcgagaacatcatgtggaagcagatctccaacgagctcaaccacatcctcctcgagaacgacatgaagttcaccgtcgtcgtcggcgacgtcgccggcatcctcgcccagggcaagaagatgatccgcccccagcccatggagtacaagtactcctggaagtcctggggcaaggccaagatcatcggcgccgacgtccagaacaccaccttcatcatcgacggccccaacacccccgagtgccccgacgaccagcgcgcctggaacatctgggaggtcgaggactacggcttcggcatcttcaccaccaacatctggctcaagctccgcgactcctacacccaggtctgcgaccaccgcctcatgtccgccgccatcaaggactccaaggccgtccacgccgacatgggctactggatcgagtccgagaagaacgagacctggaagctcgcccgcgcctccttcatcgaggtcaagacctgcatctggcccaagtcccacaccctctggtccaacggcgtcctcgagtccgagatgatcatccccaagatctacggcggccccatctcccagcacaactaccgccccggctacttcacccagaccgccggcccctggcacctcggcaagctcgagctcgacttcgacctctgcgagggcaccaccgtcgtcgtcgacggccactgcggcaaccgcggcccctccctccgcaccaccaccgtcaccggcaagatcatccacgagtggtgctgccgctcctgcaccctcccccccctccgcttcaagggcgaggacggctgctggtacggcatggagatccgccccgtcaaggagaaggaggagaacctcgtcaagtccatggtctccgccggctccggcgaggtcgactccttctccctcggcctcctctgcatctccatcatgatcgaggaggtcatgcgctcccgctggtcccgcaagatgctcatgaccggcaccctcgccgtcttcttcctcctcatcatgggccagctcacctggaacgacctcatccgcctctgcatcatggtcggcgccaacgcctccgaccgcatgggcatgggcaccacctacctcgccctcatggccaccttcaagatgcgccccatgttcgccgtcggcctcctcttccgccgcctcacctcccgcgaggtcctcctcctcaccatcggcctctccctcgtcgcctccgtcgagctccccaactccctcgaggagctcggcgacggcctcgccatgggcatcatgatcctcaagctcctcaccgacttccagtcccaccagctctgggccaccctcctctccctcaccttcatcaagaccaccttctccctccactacgcctggaagaccatggccatggtcctctccatcgtctccctcttccccctctgcctctccaccacctcccagaagaccacctggctccccgtcctcctcggctccctcggctgcaagcccctcaccatgttcctcatcgccgagaacaagatctggggccgcaagtcctggcccctcaacgagggcatcatggccgtcggcatcgtctccatcctcctctcctccctcctcaagaacgacgtccccctcgccggccccctcatcgccggcggcatgctcatcgcctgctacgtcatctccggctcctccgccgacctctccctcgagaaggccgccgaggtctcctgggagaaggaggccgagcactccggcgcctcccacaacatcctcgtcgaggtccaggacgacggcaccatgaagatcaaggacgaggagcgcgacgacaccctcaccatcctcctcaaggccaccctcctcgccgtctccggcgtctaccccctctccatccccgccaccctcttcgtctggcacttctggcagaagaagaagcagcgctccggcgtcctctgggacaccccctccccccccgaggtcgagcgcgccgtcctcgacgacggcatctaccgcatcatgcagcgcggcctcctcggccgctcccaggtcggcgtcggcgtcttccaggagaacgtcttccacaccatgtggcacgtcacccgcggcgccgtcctcatgtaccagggcaagcgcctcgagccctcctgggcctccgtcaagaaggacctcatctcctacggcggcggctggcgcctccagggctcctggaacaccggcgaggaggtccaggtcatcgccgtcgagcccggcaagaaccccaagaacgtccagaccgcccccggcaccttcaagacctccgagggcgaggtcggcgccatcgccctcgacttcaagcccggcacctccggctcccccatcgtcaaccgcgagggcaagatcgtcggcctctacggcaacggcgtcgtcaccacctccggcacctacgtctccgccatcgcccaggccaaggcctcccaggagggccccctccccgagatcgaggacgaggtcttccgcaagcgcaacctcaccatcatggacctccaccccggctccggcaagacccgccgctacctccccgccatcgtccgcgaggccatcaagcgcaagctccgcaccctcatcctcgcccccacccgcgtcgtcgcctccgagatggccgaggccctcaagggcatgcccatccgctaccagaccaccgccgtcaagtccgagcacaccggcaaggagatcgtcgacctcatgtgccacgccaccttcaccatgcgcctcctctcccccgtccgcgtccccaactacaacatgatcatcatggacgaggcccacttcaccgacccctcctccatcgccgcccgcggctacatctccacccgcgtcggcatgggcgaggccgccgccatcttcatgaccgccaccccccccggctccgtcgaggccttcccccagtccaacgccgtcatccaggacgaggagcgcgacatccccgagcgctcctggaactccggctacgagtggatcaccgacttccccggcaagaccgtctggttcgtcccctccatcaagtccggcaacgacatcgccaactgcctccgcaagaacggcaagcgcgtcatccagctctcccgcaagaccttcgacaccgagtaccagaagaccaagaacaacgactgggactacgtcgtcaccaccgacatctccgagatgggcgccaacttccgcgccgaccgcgtcatcgacccccgccgctgcctcaagcccgtcatcctcaaggacggccccgagcgcgtcatcctcgccggccccatgcccgtcaccgtcgcctccgccgcccagcgccgcggccgcatcggccgcaaccacaacaaggagggcgaccagtacatctacatgggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctccgcggcgaggcccgcaagaccttcgtcgagctcatgcgccgcggcgacctccccgtctggctctcctacaaggtcgcctccgagggcttccagtactccgaccgccgctggtgcttcgacggcgagcgcaacaaccaggtcctcgaggagaacatggacgtcgagatctggaccaaggagggcgagcgcaagaagctccgcccccgctggctcgacgcccgcacctactccgaccccctcgccctccgcgagttcaaggagttcgccgccggccgccgctccgtctccggcgacctcatcctcgagatcggcaagctcccccagcacctcacccagcgcgcccagaacgccctcgacaacctcgtcatgctccacaactccgagcagggcggccgcgcctaccgccacgccatggaggagctccccgacaccatcgagaccctcatgctcctcgccctcatcgccgtcctcaccggcggcgtcaccctcttcttcctctccggccgcggcctcggcaagacctccatcggcctcctctgcgtcatggcctcctccgtcctcctctggatggcctccgtcgagccccactggatcgccgcctccatcatcctcgagttcttcctcatggtcctcctcatccccgagcccgaccgccagcgcaccccccaggacaaccagctcgcctacgtcgtcatcggcctcctcttcatgatcctcaccgtcgccgccaacgagatgggcctcctcgagaccaccaagaaggacctcggcatcggccacgtcgccgtcgagaaccaccaccacgccgccatgctcgacgtcgacctccaccccgcctccgcctggaccctctacgccgtcgccaccaccatcatcacccccatgatgcgccacaccatcgagaacaccaccgccaacatctccctcaccgccatcgccaaccaggccgccatcctcatgggcctcgacaagggctggcccatctccaagatggacatcggcgtccccctcctcgccctcggctgctactcccaggtcaaccccctcaccctcaccgccgccgtcctcatgctcgtcgcccactacgccatcatcggccccggcctccaggccaaggccacccgcgaggcccagaagcgcaccgccgccggcatcatgaagaaccccaccgtcgacggcatcgtcgccatcgacctcgaccccgtcgtctacgacgccaagttcgagaagcagctcggccagatcatgctcctcatcctctgcacctcccagatcctcctcatgcgcaccacctgggccctctgcgagtccatcaccctcgccaccggccccctcaccaccctctgggagggctcccccggcaagttctggaacaccaccatcgccgtctccatggccaacatcttccgcggctcctacctcgccggcgccggcctcgccttctccctcatgaagtccctcggcggcggccgccgcggcaccggcgcccacggcgagaccctcggcgagaagtggaagcgccagctcaaccagctctccaagtccgagttcaacacctacaagcgctccggcatcatggaggtcgaccgctccgaggccaaggagggcctcaagcgcggcgagaccaccaagcacgccgtctcccgcggcaccgccaagctccgctggttcgtcgagcgcaacctcgtcaagcccgagggcaaggtcatcgacctcggctgcggccgcggcggctggtcctactactgcgccggcctcaagaaggtcaccgaggtcaagggctacaccaagggcggccccggccacgaggagcccatccccatggccacctacggctggaacctcgtcaagctccactccggcaaggacgtcttcttcatcccccccgagaagtgcgacaccctcctctgcgacatcggcgagtcctcccccaaccccaccatcgaggagggccgcaccctccgcgtcctcaagatggtcgagccctggctccgcggcaaccagttctgcatcaagatcctcaacccctacatgccctccgtcgtcgagaccctcgagcagatgcagcgcaagcacggcggcatgctcgtccgcaaccccctctcccgcaactccacccacgagatgtactgggtctcctgcggcaccggcaacatcgtctccgccgtcaacatgacctcccgcatgctcctcaaccgcttcaccatggcccaccgcaagcccacctacgagcgcgacgtcgacctcggcgccggcacccgccacgtcgccgtcgagcccgaggtcgccaacctcgacatcatcggccagcgcatcgagaacatcaagcacgagcacaagtccacctggcactacgacgaggacaacccctacaagacctgggcctaccacggctcctacgaggtcaagccctccggctccgcctcctccatggtcaacggcgtcgtcaagctcctcaccaagccctgggacgtcatccccatggtcacccagatcgccatgaccgacaccacccccttcggccagcagcgcgtcttcaaggagaaggtcgacacccgcacccccaaggccaagcgcggcaccgcccagatcatggaggtcaccgccaagtggctctggggcttcctctcccgcaacaagaagccccgcatctgcacccgcgaggagttcacccgcaaggtccgctccaacgccgccatcggcgccgtcttcgtcgacgagaaccagtggaactccgccaaggaggccgtcgaggacgagcgcttctgggacctcgtccaccgcgagcgcgagctccacaagcagggcaagtgcgccacctgcgtctacaacatgatgggcaagcgcgagaagaagctcggcgagttcggcaaggccaagggctcccgcgccatctggtacatgtggctcggcgcccgcttcctcgagttcgaggccctcggcttcatgaacgaggaccactggttctcccgcgagaactccctctccggcgtcgagggcgagggcctccacaagctcggctacatcctccgcgacatctccaagatccccggcggcaacatgtacgccgacgacaccgccggctgggacacccgcatcaccgaggacgacctccagaacgaggccaagatcaccgacatcatggagcccgagcacgccctcctcgccaagtccatcttcaagctcacctaccagaacaaggtcgtccgcgtccagcgccccgccaagaacggcaccgtcatggacgtcatctcccgccgcgaccagcgcggctccggccaggtcggcacctacggcctcaacaccttcaccaacatggaggcccagctcatccgccagatggagtccgagggcatcttctccccctccgagctcgagacccccaacctcgccggccgcgtcctcgactggctcgagaagcacggcgtcgagcgcctcaagcgcatggccatctccggcgacgactgcgtcgtcaagcccatcgacgaccgcttcgccaccgccctcaccgccctcaacgacatgggcaaggtccgcaaggacatcccccagtgggagccctccaagggctggaacgactggcagcaggtccccttctgctcccaccacttccaccagctcatcatgaaggacggccgcgagatcgtcgtcccctgccgcaaccaggacgagctcgtcggccgcgcccgcgtctcccagggcgccggctggtccctccgcgagaccgcctgcctcggcaagtcctacgcccagatgtggcagctcatgtacttccaccgccgcgacctccgcctcgccgccaacgccatctgctccgccgtccccgtcgactgggtccccacctcccgcaccacctggtccatccacgcccaccaccagtggatgaccaccgaggacatgctctccgtctggaaccgcgtctggatcgaggagaacccctggatggaggacaagacccacatctcctcctggggcgacgtcccctacctcggcaagcgcgaggaccagtggtgcggctccctcatcggcctcaccgcccgcgccacctgggccaccaacatccaggtcgccatcaaccaggtccgccgcctcatcggcaacgagaactacctcgactacatgacctccatgaagcgcttcaagaacgagtccgaccccgagggcgccctctggtga
